United States Patent 12,569,549 (FLAVIVIRUS VACCINE) - sequence listing, part 49

SEQ ID NO: 17743 - RNA, 9873 nt, synthetic construct
  misc_feature 1..9873: note = derived and/or modified CDS sequence (opt4) from DENV-3__KT726345__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17744 - RNA, 9873 nt, synthetic construct
  misc_feature 1..9873: note = derived and/or modified CDS sequence (opt4) from DENV-3__KT726349__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagagcatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17745 - RNA, 9873 nt, synthetic construct
  misc_feature 1..9873: note = derived and/or modified CDS sequence (opt4) from DENV-3__KT726347__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctggccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17746 - RNA, 9873 nt, synthetic construct
  misc_feature 1..9873: note = derived and/or modified CDS sequence (opt4) from DENV-3__KT726352__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccgccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17747 - RNA, 9873 nt, synthetic construct
  misc_feature 1..9873: note = derived and/or modified CDS sequence (opt4) from DENV-3__KT726356__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctgctggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17748 - RNA, 9873 nt, synthetic construct
  misc_feature 1..9873: note = derived and/or modified CDS sequence (opt4) from DENV-3__KT726342__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17749 - RNA, 9873 nt, synthetic construct
  misc_feature 1..9873: note = derived and/or modified CDS sequence (opt4) from DENV-3__KT726343__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17750 - RNA, 9873 nt, synthetic construct
  misc_feature 1..9873: note = derived and/or modified CDS sequence (opt4) from DENV-3__KT726351__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaaaggtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17751 - RNA, 9873 nt, synthetic construct
  misc_feature 1..9873: note = derived and/or modified CDS sequence (opt4) from DENV-3__KT726360__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggaccccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17752 - RNA, 9873 nt, synthetic construct
  misc_feature 1..9873: note = derived and/or modified CDS sequence (opt4) from DENV-3__KF041259__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaacgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcagactggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagagaaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaagatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17753 - RNA, 9873 nt, synthetic construct
  misc_feature 1..9873: note = derived and/or modified CDS sequence (opt4) from DENV-3__KF041258__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatgacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagagaaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacgtgctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17754 - RNA, 9873 nt, synthetic construct
  misc_feature 1..9873: note = derived and/or modified CDS sequence (opt4) from DENV-3__KF041257__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagagaaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgagagagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17755 - RNA, 9873 nt, synthetic construct
  misc_feature 1..9873: note = derived and/or modified CDS sequence (opt4) from DENV-3__KF041255__SS-prME
  source 1..9873: mol_type = other RNA
accagcctgtgcctgatgatgatcctgcccgccgccctggccttccacctgaccagcagaaacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagagaaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaagatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17756 - RNA, 9873 nt, synthetic construct
  misc_feature 1..9873: note = derived and/or modified CDS sequence (opt4) from DENV-3__KF041256__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccctgaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagagaaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgagaagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaagatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccatccactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17757 - RNA, 9873 nt, synthetic construct
  misc_feature 1..9873: note = derived and/or modified CDS sequence (opt4) from DENV-3__KF041254__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgtggtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggagaacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagagaaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccaccctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccagagccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcaagctgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17758 - RNA, 9873 nt, synthetic construct
  misc_feature 1..9873: note = derived and/or modified CDS sequence (opt4) from DENV-3__KX380841__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcatcaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggacggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccatggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17759 - RNA, 9873 nt, synthetic construct
  misc_feature 1..9873: note = derived and/or modified CDS sequence (opt4) from DENV-3__KX380842__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcatcaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgtgggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatgctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggacggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccatggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccatccccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17760 - RNA, 9873 nt, synthetic construct
  misc_feature 1..9873: note = derived and/or modified CDS sequence (opt4) from DENV-3__KX380839__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccatcacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagctgaccgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcttcagaagctacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtgggccgccctggtgagcctgatgtgcagcaacaccatcttcaccctgaccgtggcctggagaaccgccaccctgatcctggccggcatcagcctgctgcccatgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccccccacctggcccacagaaccagaaacgccctggacaacctggtgatgctgcacaccagcgagtacggcggcagagcctacagacacgccgtggaggagctgcccgagaccatggagaccctgctgctgctgggcctgatgatcctgctgaccggcggcgtgatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatcagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatgatcagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17761 - RNA, 9873 nt, synthetic construct
  misc_feature 1..9873: note = derived and/or modified CDS sequence (opt4) from DENV-3__KX380840__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccatcacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagctgaccgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcttcagaagctacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccctgagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtgggccgccctggtgagcctgatgtgcagcaacaccatcttcaccctgaccgtggcctggagaaccgccaccctgatcctggccggcatcagcctgctgcccatgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccccccacctggcccacagaaccagaaacgccctggacaacctggtgatgctgcacaccagcgagtacggcggcagagcctacagacacgccgtggaggagctgcccgagaccatggagaccctgctgctgctgggcctgatgatcctgctgaccggcggcgtgatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatcagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatgatcagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17762 - RNA, 9873 nt, synthetic construct
  misc_feature 1..9873: note = derived and/or modified CDS sequence (opt4) from DENV-3__JF808121__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcagcggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgaccatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggatcgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgaagcacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggaagaccctgggcagaaacaagaagcccagactgtgccccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcagcggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaatgacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17763 - RNA, 9873 nt, synthetic construct
  misc_feature 1..9873: note = derived and/or modified CDS sequence (opt4) from DENV-3__JF808120__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctgaagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcatcgacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgaccacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcagcggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17764 - RNA, 9873 nt, synthetic construct
  misc_feature 1..9873: note = derived and/or modified CDS sequence (opt4) from DENV-3__JF808119__SS-prME
  source 1..9873: mol_type = other RNA
accagcctgtgcctgatgatgatcctgcccaccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcatgttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcatcaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgaggactgcgtgctgaagcccatcgacgacagattcgacaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgccctgcaccagtggatgaccaccgaggacatgatcaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17765 - RNA, 9873 nt, synthetic construct
  misc_feature 1..9873: note = derived and/or modified CDS sequence (opt4) from DENV-3__JF808118__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccatcctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17766 - RNA, 9873 nt, synthetic construct
  misc_feature 1..9873: note = derived and/or modified CDS sequence (opt4) from DENV-3__JF808127__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcctgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccgagcccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgaacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaagatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccaagctgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17767 - RNA, 9873 nt, synthetic construct
  misc_feature 1..9873: note = derived and/or modified CDS sequence (opt4) from DENV-3__JF808124__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccttcggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagctggtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcacctgcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatgggcaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcctgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcggcgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcatctacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgagctggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17768 - RNA, 9873 nt, synthetic construct
  misc_feature 1..9873: note = derived and/or modified CDS sequence (opt4) from DENV-3__JF808126__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcctggacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaagagcaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccgccctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctgccccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctggtgagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcagaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaagatggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgccctggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17769 - RNA, 9873 nt, synthetic construct
  misc_feature 1..9873: note = derived and/or modified CDS sequence (opt4) from DENV-3__JF808125__SS-prME
  source 1..9873: mol_type = other RNA
accagcctgtgcctgatgatgatcctgcccgccgccctggccttccacctgaccagcagagacggcgagcccagaatgatcgtgggcgagaacgagagaggcaagagcctgctgttcaagaccgccagcggcatcaacagaagaaccctgatcgccatggacctgggcgagatgtgcgaggagaccgagacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccgccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagcagcggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgagactgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17770 - RNA, 9873 nt, synthetic construct
  misc_feature 1..9873: note = derived and/or modified CDS sequence (opt4) from DENV-3__JF808129__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcaccggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaactgcaccatgggcgtgctgtgcctggccatcctgttcgaggacgtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgaccaccgtggacgacgacggcaccatgagaatcaaggacgacgagaccgagaacatcctgaccgtgctgctgaagaccgccctgaccatcgtgagcggcgtgttcccctacagcatccccgccaccctgctggtgtggcacacctggcagaagcagacccagagaagcggcgtgctgtgggacgtgcccagcccccccgagacccagaaggccgagcaggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccacctacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaaccaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17771 - RNA, 9873 nt, synthetic construct
  misc_feature 1..9873: note = derived and/or modified CDS sequence (opt4) from DENV-3__JF808123__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccacctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctgggccccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17772 - RNA, 9873 nt, synthetic construct
  misc_feature 1..9873: note = derived and/or modified CDS sequence (opt4) from DENV-3__JF808128__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagagaaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcctggacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaagagcaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccgccctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctggtgagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaagatggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagaagcatgagctggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17773 - RNA, 9873 nt, synthetic construct
  misc_feature 1..9873: note = derived and/or modified CDS sequence (opt4) from DENV-3__JF808122__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcatcaagtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccccccacctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgagctggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaacggcagcagagccatctggtacatgtggctgggcgccagatacctggagttcgaggccctgggcttcctgaaggagtaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacaccggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17774 - RNA, 9873 nt, synthetic construct
  misc_feature 1..9873: note = derived and/or modified CDS sequence (opt4) from DENV-3__GQ466079__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcttcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctggagaacctggagctggacttcacctactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcatcctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgagcgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggctggtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcagcagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17775 - RNA, 9873 nt, synthetic construct
  misc_feature 1..9873: note = derived and/or modified CDS sequence (opt4) from DENV-3__FJ898462__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagagaggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccatcgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17776 - RNA, 9873 nt, synthetic construct
  misc_feature 1..9873: note = derived and/or modified CDS sequence (opt4) from DENV-3__KF955473__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccatcctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17777 - RNA, 9873 nt, synthetic construct
  misc_feature 1..9873: note = derived and/or modified CDS sequence (opt4) from DENV-3__FJ850079__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacgtggaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcaccggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacgacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17778 - RNA, 9873 nt, synthetic construct
  misc_feature 1..9873: note = derived and/or modified CDS sequence (opt4) from DENV-3__FJ850080__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcatgttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcatcaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17779 - RNA, 9873 nt, synthetic construct
  misc_feature 1..9873: note = derived and/or modified CDS sequence (opt4) from DENV-3__FJ850083__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagagagaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcaccatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17780 - RNA, 9873 nt, synthetic construct
  misc_feature 1..9873: note = derived and/or modified CDS sequence (opt4) from DENV-3__FJ850086__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagagccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagaccgtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcatgttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcatcaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17781 - RNA, 9873 nt, synthetic construct
  misc_feature 1..9873: note = derived and/or modified CDS sequence (opt4) from DENV-3__FJ850089__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggtgatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaaggtgggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcagatcatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17782 - RNA, 9873 nt, synthetic construct
  misc_feature 1..9873: note = derived and/or modified CDS sequence (opt4) from DENV-3__FJ850092__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggtgatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgtgaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaaggtgggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgatcgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17783 - RNA, 9873 nt, synthetic construct
  misc_feature 1..9873: note = derived and/or modified CDS sequence (opt4) from DENV-3__FJ850094__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccggcacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccttcaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacggcatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17784 - RNA, 9873 nt, synthetic construct
  misc_feature 1..9873: note = derived and/or modified CDS sequence (opt4) from DENV-3__FJ898446__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgagaccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17785 - RNA, 9873 nt, synthetic construct
  misc_feature 1..9873: note = derived and/or modified CDS sequence (opt4) from DENV-3__GU131844__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacgtgaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgcccagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcgcccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcagcggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctggccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17786 - RNA, 9873 nt, synthetic construct
  misc_feature 1..9873: note = derived and/or modified CDS sequence (opt4) from DENV-3__GU131849__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccatcgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccatgctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacagccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17787 - RNA, 9873 nt, synthetic construct
  misc_feature 1..9873: note = derived and/or modified CDS sequence (opt4) from DENV-3__GQ868546__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17788 - RNA, 9873 nt, synthetic construct
  misc_feature 1..9873: note = derived and/or modified CDS sequence (opt4) from DENV-3__GU131850__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgatcaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatcggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaacagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagaagggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17789 - RNA, 9873 nt, synthetic construct
  misc_feature 1..9873: note = derived and/or modified CDS sequence (opt4) from DENV-3__GU131851__SS-prME
  source 1..9873: mol_type = other RNA
accagcctgtgcctggtgatgatcctgcccgccgccctggccttccacctgaccagcagagacggcgagccccacatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggctgttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17790 - RNA, 9873 nt, synthetic construct
  misc_feature 1..9873: note = derived and/or modified CDS sequence (opt4) from DENV-3__GQ868547__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatggtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgcacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17791 - RNA, 9873 nt, synthetic construct
  misc_feature 1..9873: note = derived and/or modified CDS sequence (opt4) from DENV-3__GU131857__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17792 - RNA, 9873 nt, synthetic construct
  misc_feature 1..9873: note = derived and/or modified CDS sequence (opt4) from DENV-3__GU131858__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgatcaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatcggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagcggccccagcctgaccaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaacagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17793 - RNA, 9873 nt, synthetic construct
  misc_feature 1..9873: note = derived and/or modified CDS sequence (opt4) from DENV-3__GQ868548__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17794 - RNA, 9873 nt, synthetic construct
  misc_feature 1..9873: note = derived and/or modified CDS sequence (opt4) from DENV-3__GU131861__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgtgaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccgtggtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagaagatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17795 - RNA, 9873 nt, synthetic construct
  misc_feature 1..9873: note = derived and/or modified CDS sequence (opt4) from DENV-3__GU131862__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgatcaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatcggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcaccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaacagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggaagaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17796 - RNA, 9873 nt, synthetic construct
  misc_feature 1..9873: note = derived and/or modified CDS sequence (opt4) from DENV-3__GU131865__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgtgaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccgtggtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgaccggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17797 - RNA, 9873 nt, synthetic construct
  misc_feature 1..9873: note = derived and/or modified CDS sequence (opt4) from DENV-3__GU131866__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacagaagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacgcctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaaagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17798 - RNA, 9873 nt, synthetic construct
  misc_feature 1..9873: note = derived and/or modified CDS sequence (opt4) from DENV-3__GU131868__SS-prME
  source 1..9873: mol_type = other RNA
acccccctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaacaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaaggccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccagcgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccagcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgttcctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17799 - RNA, 9873 nt, synthetic construct
  misc_feature 1..9873: note = derived and/or modified CDS sequence (opt4) from DENV-3__GU131869__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacatcgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccagaagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17800 - RNA, 9873 nt, synthetic construct
  misc_feature 1..9873: note = derived and/or modified CDS sequence (opt4) from DENV-3__GU131870__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaaccacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgatcgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctggtggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17801 - RNA, 9873 nt, synthetic construct
  misc_feature 1..9873: note = derived and/or modified CDS sequence (opt4) from DENV-3__GU131871__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccaccggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17802 - RNA, 9873 nt, synthetic construct
  misc_feature 1..9873: note = derived and/or modified CDS sequence (opt4) from DENV-3__GU131872__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatggtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccacccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17803 - RNA, 9873 nt, synthetic construct
  misc_feature 1..9873: note = derived and/or modified CDS sequence (opt4) from DENV-3__GU131873__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtggtgatcaccgtgcacaccggcgaccagcaccaggtgggcaacgagacccagggcatcaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacgtgaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcatcatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17804 - RNA, 9873 nt, synthetic construct
  misc_feature 1..9873: note = derived and/or modified CDS sequence (opt4) from DENV-3__GU131874__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgcccagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcgcccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcagcggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctggccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17805 - RNA, 9873 nt, synthetic construct
  misc_feature 1..9873: note = derived and/or modified CDS sequence (opt4) from DENV-3__GU131875__SS-prME
  source 1..9873: mol_type = other RNA
accagcctgtgcctggtgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggtggacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17806 - RNA, 9873 nt, synthetic construct
  misc_feature 1..9873: note = derived and/or modified CDS sequence (opt4) from DENV-3__GU131877__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggtgatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcatcagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcagcggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17807 - RNA, 9873 nt, synthetic construct
  misc_feature 1..9873: note = derived and/or modified CDS sequence (opt4) from DENV-3__GU131878__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgccatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17808 - RNA, 9873 nt, synthetic construct
  misc_feature 1..9873: note = derived and/or modified CDS sequence (opt4) from DENV-3__FJ898455__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcacaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17809 - RNA, 9873 nt, synthetic construct
  misc_feature 1..9873: note = derived and/or modified CDS sequence (opt4) from DENV-3__GQ199891__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17810 - RNA, 9873 nt, synthetic construct
  misc_feature 1..9873: note = derived and/or modified CDS sequence (opt4) from DENV-3__FJ898443__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagatgaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagctggagggcgccatctggtga

SEQ ID NO: 17811 - RNA, 9873 nt, synthetic construct
  misc_feature 1..9873: note = derived and/or modified CDS sequence (opt4) from DENV-3__FJ898444__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacgagcagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcagagagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagaagggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17812 - RNA, 9873 nt, synthetic construct
  misc_feature 1..9873: note = derived and/or modified CDS sequence (opt4) from DENV-3__FJ898445__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagagagaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatggagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcatgctggagaccaccaagagagacctgggcatgagcaaggagcccggcgtggccagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccagaaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17813 - RNA, 9873 nt, synthetic construct
  misc_feature 1..9873: note = derived and/or modified CDS sequence (opt4) from DENV-3__GQ868571__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcatgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17814 - RNA, 9873 nt, synthetic construct
  misc_feature 1..9873: note = derived and/or modified CDS sequence (opt4) from DENV-3__GU131951__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatgagcaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgaggcccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgacccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccatcgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17815 - RNA, 9873 nt, synthetic construct
  misc_feature 1..9873: note = derived and/or modified CDS sequence (opt4) from DENV-3__GQ868572__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggtgcacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17816 - RNA, 9873 nt, synthetic construct
  misc_feature 1..9873: note = derived and/or modified CDS sequence (opt4) from DENV-3__GQ868573__SS-prME
  source 1..9873: mol_type = other RNA
accagcttctgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcctgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17817 - RNA, 9873 nt, synthetic construct
  misc_feature 1..9873: note = derived and/or modified CDS sequence (opt4) from DENV-3__GQ868574__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcagctactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcatgctggagaccaccaagagagacctgggcatgagcaaggagcccggcgtggccagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17818 - RNA, 9873 nt, synthetic construct
  misc_feature 1..9873: note = derived and/or modified CDS sequence (opt4) from DENV-3__GQ868575__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacttcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcagagagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagatccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17819 - RNA, 9873 nt, synthetic construct
  misc_feature 1..9873: note = derived and/or modified CDS sequence (opt4) from DENV-3__GU131953__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacgccgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17820 - RNA, 9873 nt, synthetic construct
  misc_feature 1..9873: note = derived and/or modified CDS sequence (opt4) from DENV-3__GQ868577__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcgcccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggagaacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17821 - RNA, 9873 nt, synthetic construct
  misc_feature 1..9873: note = derived and/or modified CDS sequence (opt4) from DENV-3__GU131954__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgtgatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgaccaaggagcccggcgccgtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17822 - RNA, 9873 nt, synthetic construct
  misc_feature 1..9873: note = derived and/or modified CDS sequence (opt4) from DENV-3__GQ868578__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcaagtggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccaccagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcgcccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatgggcaacgaggagttcctggactacatgcccagcatgaagagattcagaaaggaggaggagagcgagggcgccatctggtga

SEQ ID NO: 17823 - RNA, 9873 nt, synthetic construct
  misc_feature 1..9873: note = derived and/or modified CDS sequence (opt4) from DENV-3__FJ898457__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagaccgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17824 - RNA, 9873 nt, synthetic construct
  misc_feature 1..9873: note = derived and/or modified CDS sequence (opt4) from DENV-3__KF955505__SS-prME
  source 1..9873: mol_type = other RNA
accagcctgtgcctgatgatgatcctgcccgccgccctggccttccacctgaccagcagaaacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgccccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcccaagctgggctacatcctgagagacatcagcaagatccccggcggcgccatgtacgccgacgacaccgccggctgggacaccagaatcaccgaggacgacctgcacaacgaggagaagatcccccaccagatggaccccgagcacagcagactggccaacgccatcttcaagctgacctaccagaacaaggtggtgaaggtgcagagacccacccccaccggcaccgtgatggacatcatcagcagaaaggcccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcaccggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17825 - RNA, 9873 nt, synthetic construct
  misc_feature 1..9873: note = derived and/or modified CDS sequence (opt4) from DENV-3__FJ898464__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17826 - RNA, 9873 nt, synthetic construct
  misc_feature 1..9873: note = derived and/or modified CDS sequence (opt4) from DENV-3__JQ922556__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggcccccgccagaggcgccagaagaatggccatcctgggcgacaccgcctgggtgttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccagcacccccgagtgccccagcgccagcagagcctggaacgtgtgggaggtggaggactacggcttcggcgtgttcaccaccaacatctggctgaagctgagagaggtgtacacccagatgtgcgaccacagactgatgagccccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccttcaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgggcaccggcaccagcgccgacctgaccgtggagcaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcccccagtggcagaagggcgaggaggtgcaggtgatcaccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaacagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgagaccgagtaccagaagaccaagctgaacgactgggacttcgtgggcaccaccgacatcagcgagatgggcgccaacttcaaggccgacagagtgatcgaccccagaagatgcctgaagcccggcatcctgaccgacggccccgagggcgtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagatcaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcgtgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagctgacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcggcagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcggcagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgaccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17827 - RNA, 9873 nt, synthetic construct
  misc_feature 1..9873: note = derived and/or modified CDS sequence (opt4) from DENV-3__JQ922557__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagagactgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcaagagcaagagagacaacagcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgatgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgctgatcaccgtggacgacaacggcaccatgagaatcaaggacgacgagaccgagatcatcctgaccgtgctgctgaagaccgccctgcagatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcgactacctgagcggcatcgcccagaccaacgccgagccctacggccccagccccgacctggaggaggagatgttcaagaagagaaagctgaccatcatggacctgcaccccggcagcggccagaccctgaagtacctgcccgccatcgtgagagacgccatcaagagaagactgagaatcctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgccgagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgagaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccaagagagtgatcctggccggccccatgcccgacaccgccgccagcgccgcccagagaagaggcagagtgggcagaaacccccagaaggagaacgaccagtacatcttccccggccagcccctgaacaccgacgaggaccacgcccactggcccgagaccaagctgctgatggacctgttcaccacccccgagggcatcctgcccagccacttcgacccccacggcgagaacttccccgagatcagcggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacagccaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatgaccaccctgtgggagggcagccccggcaagatctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgcactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaaccccccctacctgggcaagagagaggaccagtggtgcggcagcatcatcggcctgagcagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17828 - RNA, 9873 nt, synthetic construct
  misc_feature 1..9873: note = derived and/or modified CDS sequence (opt4) from DENV-3__JQ922555__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccgccgaggccatcctgcccgagtacggcaccctgggcctggagtgcagccccagaaccggcctggacttcaacgagatgatcctgctgaccatgaagaacaaggcctggatgggccacagacagatgctgttcgacctgcccaccccctggaccagcggcaccaccaccgagaccagcgcctggaacagaaaggagcccttcgtgaccttcaagaacgcccacaccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctggtgaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacagaaagggcagcagcatcggcaagatgttcgaggccaccagcagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatctgcgaccacagactgatgagcgccgccgtgaaggacgagagagccgtgcacgccgacatgggctactggatcgagagccagaagaacggcagctggaagctggagaaggccagcctgatcgaggtgaagaccagcacctggcccaagagccacaccctgtggagcaacggcgtgcaggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacggcgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccagcggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgacgccaagatgctgctggagaacatcaacacccccgagggcatcatccccgccctgttcgagcccgagagagagaagagcgccggcctggacggcgagtacagactgaagggcgagagcagaaagaccttcgtggagctgatgagaagaggcgacctgcccgtgtggctggcccacaaggtggccagcgagggcatcctgtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgagcagccacctggcccacagaaccagaaacgccctggacaacaagatgatgctgcacaccagcgagtacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcgtgagcaaggagcccggcgtggtgagccccaccagctacctggacgtggacctgcaccccgccagcgcctggaccctgtacgccgtggccaccaccgtgatcgcccccatgctgagacacaccatcgagaacagcaccgccaacgtgagcatggccgccatcgccaaccaggccgtggtgctgatgggcctggacaagggctggcccatcagcaagatggacctgggcgtgcccctgctggccctgggctgctacttctacgtgaaccccctgaccctgaccgccgccgtgttcctgctggtgacccactacgccatcatcggccccggcctgcaggccaaggccaccagagaggcccacaagaagaccgccgccggcatcatgaaccccccccccggcgacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccaccaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcaagggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcagaaacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagactgatgcccagaaccagaaaggtgatggagatcaccgccgagtggctgtggagaaccctgggcagaaacaagagacccagactgtgcaccagagaggagttcaccaagaaggtgagacccatcgccgccatgggcgccgtgttcacccagagagaccagtgggacagcgccaaggccgccgtggaggacgaggagttctggaagcccgtggacagagagtgcaacagccaccagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaaacaccgaggacgacctgcacatgaaggagaagatcacccagcagatgggccccggccacagcagactggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17829 - RNA, 9873 nt, synthetic construct
  misc_feature 1..9873: note = derived and/or modified CDS sequence (opt4) from DENV-3__GU131903__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaaggccggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatggccaccggcatcgagcacctggagagactgcagagaaagtacggcggcatgctggtgagaaaccccctgagcagaaacagcacccacgagatggactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17830 - RNA, 9873 nt, synthetic construct
  misc_feature 1..9873: note = derived and/or modified CDS sequence (opt4) from DENV-3__GU131904__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacagcatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgagaaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatggccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17831 - RNA, 9873 nt, synthetic construct
  misc_feature 1..9873: note = derived and/or modified CDS sequence (opt4) from DENV-3__GU131906__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccagaagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctgggcaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17832 - RNA, 9873 nt, synthetic construct
  misc_feature 1..9873: note = derived and/or modified CDS sequence (opt4) from DENV-3__GU131907__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgaccgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 17833 - RNA, 9873 nt, synthetic construct
  misc_feature 1..9873: note = derived and/or modified CDS sequence (opt4) from DENV-3__GQ868634__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17834 - RNA, 9873 nt, synthetic construct
  misc_feature 1..9873: note = derived and/or modified CDS sequence (opt4) from DENV-3__GU131908__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctggaagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17835 - RNA, 9873 nt, synthetic construct
  misc_feature 1..9873: note = derived and/or modified CDS sequence (opt4) from DENV-3__GU131909__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17836 - RNA, 9873 nt, synthetic construct
  misc_feature 1..9873: note = derived and/or modified CDS sequence (opt4) from DENV-3__GU131912__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccaacatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcagctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaaagagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccagcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgagaatggtggagccctggctgagaaacaaccagttctgcatcaaggtgctgaacccctacatgcccaacgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcgaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17837 - RNA, 9873 nt, synthetic construct
  misc_feature 1..9873: note = derived and/or modified CDS sequence (opt4) from DENV-3__GU131913__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcgtgaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgcacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaaagagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaacgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcgaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatgggcgacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17838 - RNA, 9873 nt, synthetic construct
  misc_feature 1..9873: note = derived and/or modified CDS sequence (opt4) from DENV-3__GU131914__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgcacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaaagagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaacgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcgaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatgggcgacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17839 - RNA, 9873 nt, synthetic construct
  misc_feature 1..9873: note = derived and/or modified CDS sequence (opt4) from DENV-3__GU131915__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggccgagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17840 - RNA, 9873 nt, synthetic construct
  misc_feature 1..9873: note = derived and/or modified CDS sequence (opt4) from DENV-3__GU131916__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtgatcaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccagcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgaggacgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcagcgactacatgcccagcatgaagagattcagaaaggaggaggagagcgagggcgccatctggtga

SEQ ID NO: 17841 - RNA, 9873 nt, synthetic construct
  misc_feature 1..9873: note = derived and/or modified CDS sequence (opt4) from DENV-3__GU131917__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaagcgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcatccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgagcgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17842 - RNA, 9873 nt, synthetic construct
  misc_feature 1..9873: note = derived and/or modified CDS sequence (opt4) from DENV-3__GU131918__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaagcgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcatccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgagcgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17843 - RNA, 9873 nt, synthetic construct
  misc_feature 1..9873: note = derived and/or modified CDS sequence (opt4) from DENV-3__GU131933__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacagcatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccatgggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatggccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17844 - RNA, 9873 nt, synthetic construct
  misc_feature 1..9873: note = derived and/or modified CDS sequence (opt4) from DENV-3__GU131934__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctggatcgacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcgtgatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagaaccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatccccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 17845 - RNA, 9873 nt, synthetic construct
  misc_feature 1..9873: note = derived and/or modified CDS sequence (opt4) from DENV-3__GU131935__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgtgatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcaccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17846 - RNA, 9873 nt, synthetic construct
  misc_feature 1..9873: note = derived and/or modified CDS sequence (opt4) from DENV-3__GU131936__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagagccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgaagatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaagcaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 17847 - RNA, 9873 nt, synthetic construct
  misc_feature 1..9873: note = derived and/or modified CDS sequence (opt4) from DENV-3__GU131937__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcaccctgagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcagcctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagaacagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17848 - RNA, 9873 nt, synthetic construct
  misc_feature 1..9873: note = derived and/or modified CDS sequence (opt4) from DENV-3__GU131938__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagagccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgaagatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgaggccatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaagcaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 17849 - RNA, 9873 nt, synthetic construct
  misc_feature 1..9873: note = derived and/or modified CDS sequence (opt4) from DENV-3__GU131939__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaaagagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagagagtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaacgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcgaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17850 - RNA, 9873 nt, synthetic construct
  misc_feature 1..9873: note = derived and/or modified CDS sequence (opt4) from DENV-3__GU131940__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17851 - RNA, 9873 nt, synthetic construct
  misc_feature 1..9873: note = derived and/or modified CDS sequence (opt4) from DENV-3__GU131942__SS-prME
  source 1..9873: mol_type = other RNA
accagcctgtgcctgatgatgatgttccccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccgtgttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcgccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17852 - RNA, 9873 nt, synthetic construct
  misc_feature 1..9873: note = derived and/or modified CDS sequence (opt4) from DENV-3__GU131943__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccatctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtgggccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17853 - RNA, 9873 nt, synthetic construct
  misc_feature 1..9873: note = derived and/or modified CDS sequence (opt4) from DENV-3__GU131945__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagagccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgaagatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaagcaaccagttctgcatcaaggtgctgaacccctacatgcccaccgtgatcgagtacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 17854 - RNA, 9873 nt, synthetic construct
  misc_feature 1..9873: note = derived and/or modified CDS sequence (opt4) from DENV-3__GU131946__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcatcctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcctggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaagcgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacaacgccagagccgccgtggaggacgaggagttctggaagctggtggacagagagagagagctgcacaagctgggcaagtgcggcagctgcatctacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggacagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17855 - RNA, 9873 nt, synthetic construct
  misc_feature 1..9873: note = derived and/or modified CDS sequence (opt4) from DENV-3__FJ639712__SS-prME
  source 1..9873: mol_type = other RNA
accagcctgtgcctgatgatgatgttccccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgagtgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacgccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17856 - RNA, 9873 nt, synthetic construct
  misc_feature 1..9873: note = derived and/or modified CDS sequence (opt4) from DENV-3__FJ639713__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaagcgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcatccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgagcgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17857 - RNA, 9873 nt, synthetic construct
  misc_feature 1..9873: note = derived and/or modified CDS sequence (opt4) from DENV-3__FJ639714__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagagcggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccatcatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccggccacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 17858 - RNA, 9873 nt, synthetic construct
  misc_feature 1..9873: note = derived and/or modified CDS sequence (opt4) from DENV-3__FJ639715__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccaacatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaaagagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaacgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcgaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17859 - RNA, 9873 nt, synthetic construct
  misc_feature 1..9873: note = derived and/or modified CDS sequence (opt4) from DENV-3__KF955461__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccaggtgttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggccatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccaccagctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17860 - RNA, 9873 nt, synthetic construct
  misc_feature 1..9873: note = derived and/or modified CDS sequence (opt4) from DENV-3__FJ639719__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacccacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctggtgagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17861 - RNA, 9873 nt, synthetic construct
  misc_feature 1..9873: note = derived and/or modified CDS sequence (opt4) from DENV-3__KF955332__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacgcccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctggtgagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17862 - RNA, 9873 nt, synthetic construct
  misc_feature 1..9873: note = derived and/or modified CDS sequence (opt4) from DENV-3__FJ639720__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgagaatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccatcgacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctggtgagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17863 - RNA, 9873 nt, synthetic construct
  misc_feature 1..9873: note = derived and/or modified CDS sequence (opt4) from DENV-3__GQ868626__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccatcgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgagaaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctggccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17864 - RNA, 9873 nt, synthetic construct
  misc_feature 1..9873: note = derived and/or modified CDS sequence (opt4) from DENV-3__GQ868627__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgagaaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctggccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17865 - RNA, 9873 nt, synthetic construct
  misc_feature 1..9873: note = derived and/or modified CDS sequence (opt4) from DENV-3__FJ639721__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgtggaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctgaccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacgcccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctggtgagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17866 - RNA, 9873 nt, synthetic construct
  misc_feature 1..9873: note = derived and/or modified CDS sequence (opt4) from DENV-3__FJ639722__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgagaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacgcccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctggtgagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaagaccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17867 - RNA, 9873 nt, synthetic construct
  misc_feature 1..9873: note = derived and/or modified CDS sequence (opt4) from DENV-3__FJ639723__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccaccggcatcaacatgtgcaccctgatcgccatggacctgggcgagatgtgcgacgacaccgtgacctacaagtgccccctgatcgccgaggtggagcccgaggacatcgactgctggtgcaacctgaccagcgcctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgagaaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccaccaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccaccatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaacaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctggccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17868 - RNA, 9873 nt, synthetic construct
  misc_feature 1..9873: note = derived and/or modified CDS sequence (opt4) from DENV-3__FJ639724__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagagagtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccaccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17869 - RNA, 9873 nt, synthetic construct
  misc_feature 1..9873: note = derived and/or modified CDS sequence (opt4) from DENV-3__FJ639725__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctgggcaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17870 - RNA, 9873 nt, synthetic construct
  misc_feature 1..9873: note = derived and/or modified CDS sequence (opt4) from DENV-3__FJ639726__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagagagtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgagccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17871 - RNA, 9873 nt, synthetic construct
  misc_feature 1..9873: note = derived and/or modified CDS sequence (opt4) from DENV-3__KF955333__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgcccacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaagcccgccgacgtgccctgggaggaggaggccgagcagaccggcgtgagccacaacctgatgatcaccgtggacgacgacggccccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcaccgcccagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17872 - RNA, 9873 nt, synthetic construct
  misc_feature 1..9873: note = derived and/or modified CDS sequence (opt4) from DENV-3__GQ868628__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcgcctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17873 - RNA, 9873 nt, synthetic construct
  misc_feature 1..9873: note = derived and/or modified CDS sequence (opt4) from DENV-3__FJ639727__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaagagccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctactacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtggtgatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcagagccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17874 - RNA, 9873 nt, synthetic construct
  misc_feature 1..9873: note = derived and/or modified CDS sequence (opt4) from DENV-3__GQ868629__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17875 - RNA, 9873 nt, synthetic construct
  misc_feature 1..9873: note = derived and/or modified CDS sequence (opt4) from DENV-3__FJ639728__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17876 - RNA, 9873 nt, synthetic construct
  misc_feature 1..9873: note = derived and/or modified CDS sequence (opt4) from DENV-3__FJ639729__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggaacctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17877 - RNA, 9873 nt, synthetic construct
  misc_feature 1..9873: note = derived and/or modified CDS sequence (opt4) from DENV-3__FJ639730__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagaaggccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacaaggagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagaagctgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17878 - RNA, 9873 nt, synthetic construct
  misc_feature 1..9873: note = derived and/or modified CDS sequence (opt4) from DENV-3__KF955464__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccatcctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccaacatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaaagagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgagaatggtggagccctggctgagaaacaaccagttctgcatcaaggtgctgaacccctacatgcccaacgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcgaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgcccactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17879 - RNA, 9873 nt, synthetic construct
  misc_feature 1..9873: note = derived and/or modified CDS sequence (opt4) from DENV-3__FJ639731__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccgtgctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacaaggagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17880 - RNA, 9873 nt, synthetic construct
  misc_feature 1..9873: note = derived and/or modified CDS sequence (opt4) from DENV-3__HM181933__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaagacccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17881 - RNA, 9873 nt, synthetic construct
  misc_feature 1..9873: note = derived and/or modified CDS sequence (opt4) from DENV-3__JF295012__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 17882 - RNA, 9873 nt, synthetic construct
  misc_feature 1..9873: note = derived and/or modified CDS sequence (opt4) from DENV-3__FJ898463__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcaccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggaccaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17883 - RNA, 9873 nt, synthetic construct
  misc_feature 1..9873: note = derived and/or modified CDS sequence (opt4) from DENV-3__GQ868616__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcaccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgccctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcacccccgagtggctgtggagacccctgggcagaaacaagaagcccagactgtgccccagagaggagttcaccaagaaggtgagaaccaacgcccccatgggcgccgtgttcaccgaggagacccagtgggccagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcccaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17884 - RNA, 9873 nt, synthetic construct
  misc_feature 1..9873: note = derived and/or modified CDS sequence (opt4) from DENV-3__GQ199887__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctggtgaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatgttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcagaaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgtgatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagagagacgtggacctgggcgccggcaccagacacgtgaacgccgagcccgagatccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17885 - RNA, 9873 nt, synthetic construct
  misc_feature 1..9873: note = derived and/or modified CDS sequence (opt4) from DENV-3__GQ199888__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctggtgaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatgttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcagaaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagagagacgtggacctgggcgccggcaccagacacgtgaacgccgagcccgagatccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgaggacgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17886 - RNA, 9873 nt, synthetic construct
  misc_feature 1..9873: note = derived and/or modified CDS sequence (opt4) from DENV-3__GQ252674__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcatcggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagacgtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcctgaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaacgccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagagaggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatccccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaaaggtgatgggcatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagacaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggagaacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17887 - RNA, 9873 nt, synthetic construct
  misc_feature 1..9873: note = derived and/or modified CDS sequence (opt4) from DENV-3__GQ199889__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatcctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcatgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccagcgccgagcccgacggccccacccccgagctggaggaggagatgttcagaaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccaccagacacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagagagacgtggacctgggcgccggcaccagacacgtgaacgccgagcccgagatccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17888 - RNA, 9873 nt, synthetic construct
  misc_feature 1..9873: note = derived and/or modified CDS sequence (opt4) from DENV-3__FJ882571__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagacgtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcctgaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgatcgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatgggcatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagacaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggcatgcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctggccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17889 - RNA, 9873 nt, synthetic construct
  misc_feature 1..9873: note = derived and/or modified CDS sequence (opt4) from DENV-3__FJ882572__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcatgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccagcgccgagcccgacggccccacccccgagctggaggaggagatgttcagaaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagagagacgtggacctgggcgccggcaccagacacgtgaacgccgagcccgagatccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17890 - RNA, 9873 nt, synthetic construct
  misc_feature 1..9873: note = derived and/or modified CDS sequence (opt4) from DENV-3__FJ882573__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctgggccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacacccccatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccaccggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgaggtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatgatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtggtgcccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagagtgaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcatccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgaccaaggccgacctggagaacccccacctgctggagaagaagatcacccagtggctggaggccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggagaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17891 - RNA, 9873 nt, synthetic construct
  misc_feature 1..9873: note = derived and/or modified CDS sequence (opt4) from DENV-3__FJ898440__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcatcaccgaggccatcctgcccgagtacggcaccctgggcctggagtgcagccccagaaccggcctggacttcaacgagatggtgctgctgaccatgaagaacaaggcctggatggtgcacagacagtggttcttcgacctgcccctgccctggaccagcggcgccaccaccgagacccccatctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgcagcccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagaaggacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatgaaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17892 - RNA, 9873 nt, synthetic construct
  misc_feature 1..9873: note = derived and/or modified CDS sequence (opt4) from DENV-3__FJ898441__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaagatggtgcagtacgagaacctgaagtacaccgtgatcatcaccgtgcacaccggcgaccagcaccaggtgggcaacgagacccagggcgtgaccgccgagatcaccccccaggccagcatcaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccaccatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccaggtgttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgccgacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgcagcccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagaaggacctgggcatgagcaaggagcccggcgtggtgagcagcaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgaccggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagagagacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaaaggtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaccatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17893 - RNA, 9873 nt, synthetic construct
  misc_feature 1..9873: note = derived and/or modified CDS sequence (opt4) from DENV-3__FJ898442__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaagatggtgcagtacgagaacctgaagtacaccgtgatcatcaccgtgcacaccggcgaccagcaccaggtgggcaacgagacccagggcgtgaccgccgagatcaccccccaggccagcatcaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccaccatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccaggtgttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccagaagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgccgacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgcagcccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagaaggacctgggcatgagcaaggagcccggcgtggtgagcagcaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgaccggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagagagacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaaaggtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaccatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgagaacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17894 - RNA, 9873 nt, synthetic construct
  misc_feature 1..9873: note = derived and/or modified CDS sequence (opt4) from DENV-3__FJ882575__SS-prME
  source 1..9873: mol_type = other RNA
accagcctgtgcctgatgatgatcctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcatcctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtggacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatgggcatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17895 - RNA, 9873 nt, synthetic construct
  misc_feature 1..9873: note = derived and/or modified CDS sequence (opt4) from DENV-3__GQ199886__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatgggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17896 - RNA, 9873 nt, synthetic construct
  misc_feature 1..9873: note = derived and/or modified CDS sequence (opt4) from DENV-3__FJ882576__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctggcctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17897 - RNA, 9873 nt, synthetic construct
  misc_feature 1..9873: note = derived and/or modified CDS sequence (opt4) from DENV-3__FJ850052__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacaaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17898 - RNA, 9873 nt, synthetic construct
  misc_feature 1..9873: note = derived and/or modified CDS sequence (opt4) from DENV-3__FJ873812__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcagcaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17899 - RNA, 9873 nt, synthetic construct
  misc_feature 1..9873: note = derived and/or modified CDS sequence (opt4) from DENV-3__FJ873813__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagataccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17900 - RNA, 9873 nt, synthetic construct
  misc_feature 1..9873: note = derived and/or modified CDS sequence (opt4) from DENV-3__FJ850048__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17901 - RNA, 9873 nt, synthetic construct
  misc_feature 1..9873: note = derived and/or modified CDS sequence (opt4) from DENV-3__FJ850049__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccaacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17902 - RNA, 9873 nt, synthetic construct
  misc_feature 1..9873: note = derived and/or modified CDS sequence (opt4) from DENV-3__FJ898476__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17903 - RNA, 9873 nt, synthetic construct
  misc_feature 1..9873: note = derived and/or modified CDS sequence (opt4) from DENV-3__FJ898475__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17904 - RNA, 9873 nt, synthetic construct
  misc_feature 1..9873: note = derived and/or modified CDS sequence (opt4) from DENV-3__GQ199861__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccaacgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17905 - RNA, 9873 nt, synthetic construct
  misc_feature 1..9873: note = derived and/or modified CDS sequence (opt4) from DENV-3__GQ199862__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccgtgaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17906 - RNA, 9873 nt, synthetic construct
  misc_feature 1..9873: note = derived and/or modified CDS sequence (opt4) from DENV-3__GQ199863__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggtgatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaatctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17907 - RNA, 9873 nt, synthetic construct
  misc_feature 1..9873: note = derived and/or modified CDS sequence (opt4) from DENV-3__GQ199864__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctgaacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatcggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17908 - RNA, 9873 nt, synthetic construct
  misc_feature 1..9873: note = derived and/or modified CDS sequence (opt4) from DENV-3__GQ199865__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctggggcgaggaggccgagcagaccggcgtgagccacatgctgatgatcaccgtggaggacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17909 - RNA, 9873 nt, synthetic construct
  misc_feature 1..9873: note = derived and/or modified CDS sequence (opt4) from DENV-3__GQ199870__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgagctggatcagcaacggcaccggcaacatcgtggccagcgtgaacatggtgagcagactgctgctgaacagaagcaccatgacccacagaagacccaccatcgagaaggacgtggacctgggcgccggccccagacacgtgaacgccgaccccgagccccccaacatggacgtgatcggcgagagaatcaagagagtgaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgccccagatggccatgaccgacaccacccccttcggccagcagagagtgttcaaggagaaggtggacaccagaacccccagaagcatccccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17910 - RNA, 9873 nt, synthetic construct
  misc_feature 1..9873: note = derived and/or modified CDS sequence (opt4) from DENV-3__JF937630__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17911 - RNA, 9873 nt, synthetic construct
  misc_feature 1..9873: note = derived and/or modified CDS sequence (opt4) from DENV-3__JN000936__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtggtgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcaccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgacgacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17912 - RNA, 9873 nt, synthetic construct
  misc_feature 1..9873: note = derived and/or modified CDS sequence (opt4) from DENV-3__HQ541796__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacaccgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgaccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17913 - RNA, 9873 nt, synthetic construct
  misc_feature 1..9873: note = derived and/or modified CDS sequence (opt4) from DENV-3__HQ166034__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcgccgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17914 - RNA, 9873 nt, synthetic construct
  misc_feature 1..9873: note = derived and/or modified CDS sequence (opt4) from DENV-3__HM756274__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17915 - RNA, 9873 nt, synthetic construct
  misc_feature 1..9873: note = derived and/or modified CDS sequence (opt4) from DENV-3__HM756275__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17916 - RNA, 9873 nt, synthetic construct
  misc_feature 1..9873: note = derived and/or modified CDS sequence (opt4) from DENV-3__JF937632__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatcggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagagagccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcccccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacagactgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17917 - RNA, 9873 nt, synthetic construct
  misc_feature 1..9873: note = derived and/or modified CDS sequence (opt4) from DENV-3__HM756281__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccaaggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcagagagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17918 - RNA, 9873 nt, synthetic construct
  misc_feature 1..9873: note = derived and/or modified CDS sequence (opt4) from DENV-3__JF937643__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagaaggccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcgcccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcgccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccgtgatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgacgacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17919 - RNA, 9873 nt, synthetic construct
  misc_feature 1..9873: note = derived and/or modified CDS sequence (opt4) from DENV-3__HM181972__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggtgctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctggggcaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17920 - RNA, 9873 nt, synthetic construct
  misc_feature 1..9873: note = derived and/or modified CDS sequence (opt4) from DENV-3__HM631857__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacaccgcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgccgacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccgtgatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgtggagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17921 - RNA, 9873 nt, synthetic construct
  misc_feature 1..9873: note = derived and/or modified CDS sequence (opt4) from DENV-3__HM631860__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccaaggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacacctacttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17922 - RNA, 9873 nt, synthetic construct
  misc_feature 1..9873: note = derived and/or modified CDS sequence (opt4) from DENV-3__HM181977__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccaaggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17923 - RNA, 9873 nt, synthetic construct
  misc_feature 1..9873: note = derived and/or modified CDS sequence (opt4) from DENV-3__HM181978__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcagcgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17924 - RNA, 9873 nt, synthetic construct
  misc_feature 1..9873: note = derived and/or modified CDS sequence (opt4) from DENV-3__JN183884__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaagatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17925 - RNA, 9873 nt, synthetic construct
  misc_feature 1..9873: note = derived and/or modified CDS sequence (opt4) from DENV-3__HQ541785__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcgccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcaccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgacgacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17926 - RNA, 9873 nt, synthetic construct
  misc_feature 1..9873: note = derived and/or modified CDS sequence (opt4) from DENV-3__HM181975__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgatccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17927 - RNA, 9873 nt, synthetic construct
  misc_feature 1..9873: note = derived and/or modified CDS sequence (opt4) from DENV-3__HM631864__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagaaggccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacagcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcgccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccgtgatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgacgacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17928 - RNA, 9873 nt, synthetic construct
  misc_feature 1..9873: note = derived and/or modified CDS sequence (opt4) from DENV-3__HM631859__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggagactggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17929 - RNA, 9870 nt, synthetic construct
  misc_feature 1..9870: note = derived and/or modified CDS sequence (opt4) from DENV-3__HM631856__SS-prME
  source 1..9870: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccaaggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcagaaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17930 - RNA, 9873 nt, synthetic construct
  misc_feature 1..9873: note = derived and/or modified CDS sequence (opt4) from DENV-3__HM756276__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17931 - RNA, 9873 nt, synthetic construct
  misc_feature 1..9873: note = derived and/or modified CDS sequence (opt4) from DENV-3__HM756279__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacaccgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcaacttctgggagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgaccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17932 - RNA, 9873 nt, synthetic construct
  misc_feature 1..9873: note = derived and/or modified CDS sequence (opt4) from DENV-3__HQ891025__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgaacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17933 - RNA, 9873 nt, synthetic construct
  misc_feature 1..9873: note = derived and/or modified CDS sequence (opt4) from DENV-3__HQ705617__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcagaatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17934 - RNA, 9873 nt, synthetic construct
  misc_feature 1..9873: note = derived and/or modified CDS sequence (opt4) from DENV-3__HQ705619__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagaccctgacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17935 - RNA, 9873 nt, synthetic construct
  misc_feature 1..9873: note = derived and/or modified CDS sequence (opt4) from DENV-3__HQ705620__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctgggtgggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaagactgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17936 - RNA, 9873 nt, synthetic construct
  misc_feature 1..9873: note = derived and/or modified CDS sequence (opt4) from DENV-3__HQ705621__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcaccacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17937 - RNA, 9873 nt, synthetic construct
  misc_feature 1..9873: note = derived and/or modified CDS sequence (opt4) from DENV-3__HQ671176__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17938 - RNA, 9873 nt, synthetic construct
  misc_feature 1..9873: note = derived and/or modified CDS sequence (opt4) from DENV-3__HQ705609__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccaaggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccatcgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcagagagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17939 - RNA, 9873 nt, synthetic construct
  misc_feature 1..9873: note = derived and/or modified CDS sequence (opt4) from DENV-3__HQ705610__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccatctggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggaaggacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcagcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17940 - RNA, 9873 nt, synthetic construct
  misc_feature 1..9873: note = derived and/or modified CDS sequence (opt4) from DENV-3__HQ705611__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagaagatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17941 - RNA, 9873 nt, synthetic construct
  misc_feature 1..9873: note = derived and/or modified CDS sequence (opt4) from DENV-3__HQ705612__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacaccacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17942 - RNA, 9873 nt, synthetic construct
  misc_feature 1..9873: note = derived and/or modified CDS sequence (opt4) from DENV-3__HQ705613__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaactaccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccaccagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17943 - RNA, 9873 nt, synthetic construct
  misc_feature 1..9873: note = derived and/or modified CDS sequence (opt4) from DENV-3__HQ705615__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcgccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcaccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctaccactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgacgacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17944 - RNA, 9873 nt, synthetic construct
  misc_feature 1..9873: note = derived and/or modified CDS sequence (opt4) from DENV-3__JF920398__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccatctggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17945 - RNA, 9873 nt, synthetic construct
  misc_feature 1..9873: note = derived and/or modified CDS sequence (opt4) from DENV-3__JF920402__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcgccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17946 - RNA, 9873 nt, synthetic construct
  misc_feature 1..9873: note = derived and/or modified CDS sequence (opt4) from DENV-3__JF937652__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacaacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagctggtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagctgggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatgggcgcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17947 - RNA, 9873 nt, synthetic construct
  misc_feature 1..9873: note = derived and/or modified CDS sequence (opt4) from DENV-3__JF920404__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggagggcgccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17948 - RNA, 9873 nt, synthetic construct
  misc_feature 1..9873: note = derived and/or modified CDS sequence (opt4) from DENV-3__JF937641__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17949 - RNA, 9873 nt, synthetic construct
  misc_feature 1..9873: note = derived and/or modified CDS sequence (opt4) from DENV-3__JF920396__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgccctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17950 - RNA, 9873 nt, synthetic construct
  misc_feature 1..9873: note = derived and/or modified CDS sequence (opt4) from DENV-3__JF920406__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcgagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17951 - RNA, 9873 nt, synthetic construct
  misc_feature 1..9873: note = derived and/or modified CDS sequence (opt4) from DENV-3__JF920409__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctggcccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgccttcttcatgttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagagcgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17952 - RNA, 9873 nt, synthetic construct
  misc_feature 1..9873: note = derived and/or modified CDS sequence (opt4) from DENV-3__JF920408__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacggcacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccggcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggaggtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccgacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17953 - RNA, 9873 nt, synthetic construct
  misc_feature 1..9873: note = derived and/or modified CDS sequence (opt4) from DENV-3__JF920397__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggacctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17954 - RNA, 9873 nt, synthetic construct
  misc_feature 1..9873: note = derived and/or modified CDS sequence (opt4) from DENV-3__JN093513__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacaccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17955 - RNA, 9873 nt, synthetic construct
  misc_feature 1..9873: note = derived and/or modified CDS sequence (opt4) from DENV-3__JF937624__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccatcaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagaatcatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17956 - RNA, 9873 nt, synthetic construct
  misc_feature 1..9873: note = derived and/or modified CDS sequence (opt4) from DENV-3__JN000938__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccttcagcgagaaggaggagaacatggtgaagagcctggtgagcgccggcggcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17957 - RNA, 9873 nt, synthetic construct
  misc_feature 1..9873: note = derived and/or modified CDS sequence (opt4) from DENV-3__JN093515__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagagagaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacatcatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtgaacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17958 - RNA, 9873 nt, synthetic construct
  misc_feature 1..9873: note = derived and/or modified CDS sequence (opt4) from DENV-3__JF937646__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcatcggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggtgaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggtgggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17959 - RNA, 9873 nt, synthetic construct
  misc_feature 1..9873: note = derived and/or modified CDS sequence (opt4) from DENV-3__JF937633__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcaccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17960 - RNA, 9873 nt, synthetic construct
  misc_feature 1..9873: note = derived and/or modified CDS sequence (opt4) from DENV-3__JF937634__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgtgaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggaggtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccgacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17961 - RNA, 9873 nt, synthetic construct
  misc_feature 1..9873: note = derived and/or modified CDS sequence (opt4) from DENV-3__JF937636__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcatcctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcagaagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17962 - RNA, 9873 nt, synthetic construct
  misc_feature 1..9873: note = derived and/or modified CDS sequence (opt4) from DENV-3__JF937626__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtggtgcccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17963 - RNA, 9873 nt, synthetic construct
  misc_feature 1..9873: note = derived and/or modified CDS sequence (opt4) from DENV-3__JF937621__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagagagccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17964 - RNA, 9873 nt, synthetic construct
  misc_feature 1..9873: note = derived and/or modified CDS sequence (opt4) from DENV-3__JF937623__SS-prME
  source 1..9873: mol_type = other RNA
gccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcatcttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcatctacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17965 - RNA, 9873 nt, synthetic construct
  misc_feature 1..9873: note = derived and/or modified CDS sequence (opt4) from DENV-3__JF937637__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacgccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgctgaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17966 - RNA, 9873 nt, synthetic construct
  misc_feature 1..9873: note = derived and/or modified CDS sequence (opt4) from DENV-3__JF937638__SS-prME
  source 1..9873: mol_type = other RNA
accagcctgtgcctgctgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaagactgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgcagaagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgacccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacctgacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagatcatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17967 - RNA, 9873 nt, synthetic construct
  misc_feature 1..9873: note = derived and/or modified CDS sequence (opt4) from DENV-3__JF937639__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcagaaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggcctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccatctggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccaagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17968 - RNA, 9873 nt, synthetic construct
  misc_feature 1..9873: note = derived and/or modified CDS sequence (opt4) from DENV-3__JF937627__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagagagaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccatgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacatcatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtgaacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17969 - RNA, 9873 nt, synthetic construct
  misc_feature 1..9873: note = derived and/or modified CDS sequence (opt4) from DENV-3__KF973476__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatcggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaagactgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagaggcggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaccagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccctacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17970 - RNA, 9873 nt, synthetic construct
  misc_feature 1..9873: note = derived and/or modified CDS sequence (opt4) from DENV-3__KF973478__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccagccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacagactgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17971 - RNA, 9873 nt, synthetic construct
  misc_feature 1..9873: note = derived and/or modified CDS sequence (opt4) from DENV-3__KF973479__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacctgggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcagcgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17972 - RNA, 9873 nt, synthetic construct
  misc_feature 1..9873: note = derived and/or modified CDS sequence (opt4) from DENV-3__KF973480__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatcttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgccctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17973 - RNA, 9873 nt, synthetic construct
  misc_feature 1..9873: note = derived and/or modified CDS sequence (opt4) from DENV-3__KF973481__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccatcatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccgtgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17974 - RNA, 9873 nt, synthetic construct
  misc_feature 1..9873: note = derived and/or modified CDS sequence (opt4) from DENV-3__KF973482__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccatcatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccgtgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgaccaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17975 - RNA, 9873 nt, synthetic construct
  misc_feature 1..9873: note = derived and/or modified CDS sequence (opt4) from DENV-3__KF973483__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcagaaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgtgggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagagacctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccatctggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17976 - RNA, 9873 nt, synthetic construct
  misc_feature 1..9873: note = derived and/or modified CDS sequence (opt4) from DENV-3__KF973485__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgcacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggaagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggaggtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacatggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccgacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17977 - RNA, 9873 nt, synthetic construct
  misc_feature 1..9873: note = derived and/or modified CDS sequence (opt4) from DENV-3__KF973486__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcggcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgcccccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggacttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17978 - RNA, 9873 nt, synthetic construct
  misc_feature 1..9873: note = derived and/or modified CDS sequence (opt4) from DENV-3__FJ898458__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagaccctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggaagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17979 - RNA, 9873 nt, synthetic construct
  misc_feature 1..9873: note = derived and/or modified CDS sequence (opt4) from DENV-3__KJ189256__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17980 - RNA, 9873 nt, synthetic construct
  misc_feature 1..9873: note = derived and/or modified CDS sequence (opt4) from DENV-3__KJ189257__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacaccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgttcctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17981 - RNA, 9873 nt, synthetic construct
  misc_feature 1..9873: note = derived and/or modified CDS sequence (opt4) from DENV-3__KJ189262__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccatcgagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17982 - RNA, 9873 nt, synthetic construct
  misc_feature 1..9873: note = derived and/or modified CDS sequence (opt4) from DENV-3__KJ189263__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccgtgctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17983 - RNA, 9873 nt, synthetic construct
  misc_feature 1..9873: note = derived and/or modified CDS sequence (opt4) from DENV-3__KJ189265__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcacggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacaccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccaacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17984 - RNA, 9873 nt, synthetic construct
  misc_feature 1..9873: note = derived and/or modified CDS sequence (opt4) from DENV-3__KJ189266__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccatcgagcccggcaagaaccccaagaacttccaggccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17985 - RNA, 9873 nt, synthetic construct
  misc_feature 1..9873: note = derived and/or modified CDS sequence (opt4) from DENV-3__KJ189268__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccaagaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17986 - RNA, 9873 nt, synthetic construct
  misc_feature 1..9873: note = derived and/or modified CDS sequence (opt4) from DENV-3__KJ189271__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagctgggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17987 - RNA, 9873 nt, synthetic construct
  misc_feature 1..9873: note = derived and/or modified CDS sequence (opt4) from DENV-3__KJ189272__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccctacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgagcatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17988 - RNA, 9873 nt, synthetic construct
  misc_feature 1..9873: note = derived and/or modified CDS sequence (opt4) from DENV-3__KJ189273__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggtgaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17989 - RNA, 9873 nt, synthetic construct
  misc_feature 1..9873: note = derived and/or modified CDS sequence (opt4) from DENV-3__KJ189274__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcagaagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcagagaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17990 - RNA, 9873 nt, synthetic construct
  misc_feature 1..9873: note = derived and/or modified CDS sequence (opt4) from DENV-3__KJ189275__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcagaagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcagagaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17991 - RNA, 9873 nt, synthetic construct
  misc_feature 1..9873: note = derived and/or modified CDS sequence (opt4) from DENV-3__KJ189276__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctgcagtgcagccccagaaccggcctggacttcaacgagatgatcctgctgaccatgaagaacaaggcctggatggtgcacagacagtggttcttcgacctgcccctgccctggaccagcggcgccaccagcgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtggaacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaagactggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17992 - RNA, 9873 nt, synthetic construct
  misc_feature 1..9873: note = derived and/or modified CDS sequence (opt4) from DENV-3__KJ189277__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctgcagtgcagccccagaaccggcctggacttcaacgagatgatcctgctgaccatgaagaacaaggcctggatggtgcacagacagtggttcttcgacctgcccctgccctggaccagcggcgccaccagcgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggcctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtggaacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaagactggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17993 - RNA, 9873 nt, synthetic construct
  misc_feature 1..9873: note = derived and/or modified CDS sequence (opt4) from DENV-3__KJ189278__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacgtgaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17994 - RNA, 9873 nt, synthetic construct
  misc_feature 1..9873: note = derived and/or modified CDS sequence (opt4) from DENV-3__KJ189279__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggtgaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccatcaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17995 - RNA, 9873 nt, synthetic construct
  misc_feature 1..9873: note = derived and/or modified CDS sequence (opt4) from DENV-3__KJ189280__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtgagcagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17996 - RNA, 9873 nt, synthetic construct
  misc_feature 1..9873: note = derived and/or modified CDS sequence (opt4) from DENV-3__KJ189281__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggtgctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17997 - RNA, 9873 nt, synthetic construct
  misc_feature 1..9873: note = derived and/or modified CDS sequence (opt4) from DENV-3__KJ189282__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggcctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatggccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 17998 - RNA, 9873 nt, synthetic construct
  misc_feature 1..9873: note = derived and/or modified CDS sequence (opt4) from DENV-3__KJ189283__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaagaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 17999 - RNA, 9873 nt, synthetic construct
  misc_feature 1..9873: note = derived and/or modified CDS sequence (opt4) from DENV-3__KJ189284__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggtgaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18000 - RNA, 9873 nt, synthetic construct
  misc_feature 1..9873: note = derived and/or modified CDS sequence (opt4) from DENV-3__KJ189286__SS-prME
  source 1..9873: mol_type = other RNA
accagcttctgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18001 - RNA, 9873 nt, synthetic construct
  misc_feature 1..9873: note = derived and/or modified CDS sequence (opt4) from DENV-3__KJ189287__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagaaacatggcccacaccctgatcatgatcggcagcaacgccagcgacagaatgggcatgggcgtgacctacctggccctgatcgccaccttcaagatccagcccttcctggtgctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatggccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18002 - RNA, 9873 nt, synthetic construct
  misc_feature 1..9873: note = derived and/or modified CDS sequence (opt4) from DENV-3__KJ189288__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaagatggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacgtgaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggcctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctggtgcccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18003 - RNA, 9873 nt, synthetic construct
  misc_feature 1..9873: note = derived and/or modified CDS sequence (opt4) from DENV-3__KJ189289__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagcagcaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaagaccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18004 - RNA, 9873 nt, synthetic construct
  misc_feature 1..9873: note = derived and/or modified CDS sequence (opt4) from DENV-3__KJ189290__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagaaacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagagaagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18005 - RNA, 9873 nt, synthetic construct
  misc_feature 1..9873: note = derived and/or modified CDS sequence (opt4) from DENV-3__KJ189291__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagaaacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagagaagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggaccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18006 - RNA, 9873 nt, synthetic construct
  misc_feature 1..9873: note = derived and/or modified CDS sequence (opt4) from DENV-3__KJ189292__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggccgagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcatgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcatcatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggcagcacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaagatcagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18007 - RNA, 9873 nt, synthetic construct
  misc_feature 1..9873: note = derived and/or modified CDS sequence (opt4) from DENV-3__KJ189293__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18008 - RNA, 9873 nt, synthetic construct
  misc_feature 1..9873: note = derived and/or modified CDS sequence (opt4) from DENV-3__KJ189294__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18009 - RNA, 9873 nt, synthetic construct
  misc_feature 1..9873: note = derived and/or modified CDS sequence (opt4) from DENV-3__KJ189295__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgctgaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacagaacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18010 - RNA, 9873 nt, synthetic construct
  misc_feature 1..9873: note = derived and/or modified CDS sequence (opt4) from DENV-3__KJ189297__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagccagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18011 - RNA, 9873 nt, synthetic construct
  misc_feature 1..9873: note = derived and/or modified CDS sequence (opt4) from DENV-3__KJ189298__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagaaacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18012 - RNA, 9873 nt, synthetic construct
  misc_feature 1..9873: note = derived and/or modified CDS sequence (opt4) from DENV-3__KJ189301__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccacggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacgtgaagctgaccgtggtggtgggcgacatcatcggcgtgctggagagaggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgagactgagagaggcctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctggtgcccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18013 - RNA, 9873 nt, synthetic construct
  misc_feature 1..9873: note = derived and/or modified CDS sequence (opt4) from DENV-3__KF955456__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctggtgatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccatccagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18014 - RNA, 9873 nt, synthetic construct
  misc_feature 1..9873: note = derived and/or modified CDS sequence (opt4) from DENV-3__KF955465__SS-prME
  source 1..9873: mol_type = other RNA
accagcctgtgcatcatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatggtgctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18015 - RNA, 9873 nt, synthetic construct
  misc_feature 1..9873: note = derived and/or modified CDS sequence (opt4) from DENV-3__KF955466__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatgctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18016 - RNA, 9873 nt, synthetic construct
  misc_feature 1..9873: note = derived and/or modified CDS sequence (opt4) from DENV-3__KF955468__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcctgaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcagagtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaccctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18017 - RNA, 9873 nt, synthetic construct
  misc_feature 1..9873: note = derived and/or modified CDS sequence (opt4) from DENV-3__FJ744726__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagaaggacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18018 - RNA, 9873 nt, synthetic construct
  misc_feature 1..9873: note = derived and/or modified CDS sequence (opt4) from DENV-3__FJ744729__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctgaagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgagaagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18019 - RNA, 9873 nt, synthetic construct
  misc_feature 1..9873: note = derived and/or modified CDS sequence (opt4) from DENV-3__FJ687448__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18020 - RNA, 9873 nt, synthetic construct
  misc_feature 1..9873: note = derived and/or modified CDS sequence (opt4) from DENV-3__FJ744732__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18021 - RNA, 9873 nt, synthetic construct
  misc_feature 1..9873: note = derived and/or modified CDS sequence (opt4) from DENV-3__FJ810414__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggccaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18022 - RNA, 9873 nt, synthetic construct
  misc_feature 1..9873: note = derived and/or modified CDS sequence (opt4) from DENV-3__FJ744734__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccatgggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18023 - RNA, 9873 nt, synthetic construct
  misc_feature 1..9873: note = derived and/or modified CDS sequence (opt4) from DENV-3__FJ744737__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18024 - RNA, 9873 nt, synthetic construct
  misc_feature 1..9873: note = derived and/or modified CDS sequence (opt4) from DENV-3__FJ744739__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgtgagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagatggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcttcatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18025 - RNA, 9873 nt, synthetic construct
  misc_feature 1..9873: note = derived and/or modified CDS sequence (opt4) from DENV-3__FJ744740__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatcgccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcgtgggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcatcctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtgaccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggtggacctggagaacccccacctgctggagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18026 - RNA, 9873 nt, synthetic construct
  misc_feature 1..9873: note = derived and/or modified CDS sequence (opt4) from DENV-3__GQ868593__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatcctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgctgctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggccacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcaccagacacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcaagaaggaggaggagagcgagggcgccatctggtga

SEQ ID NO: 18027 - RNA, 9873 nt, synthetic construct
  misc_feature 1..9873: note = derived and/or modified CDS sequence (opt4) from DENV-3__FJ898459__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaaggtgcagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18028 - RNA, 9873 nt, synthetic construct
  misc_feature 1..9873: note = derived and/or modified CDS sequence (opt4) from DENV-3__EU482555__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggacctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18029 - RNA, 9873 nt, synthetic construct
  misc_feature 1..9873: note = derived and/or modified CDS sequence (opt4) from DENV-3__EU529692__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggacctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccgtggtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18030 - RNA, 9873 nt, synthetic construct
  misc_feature 1..9873: note = derived and/or modified CDS sequence (opt4) from DENV-3__EU482558__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacaccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18031 - RNA, 9873 nt, synthetic construct
  misc_feature 1..9873: note = derived and/or modified CDS sequence (opt4) from DENV-3__EU482563__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18032 - RNA, 9873 nt, synthetic construct
  misc_feature 1..9873: note = derived and/or modified CDS sequence (opt4) from DENV-3__EU529696__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggacctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccgtggtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18033 - RNA, 9873 nt, synthetic construct
  misc_feature 1..9873: note = derived and/or modified CDS sequence (opt4) from DENV-3__EU529697__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacccacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctgaacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18034 - RNA, 9873 nt, synthetic construct
  misc_feature 1..9873: note = derived and/or modified CDS sequence (opt4) from DENV-3__EU482564__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggacctggacttcaactactgcgagggcaccaccgtggtgatcaccgagaactgcggcaccagaagacccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccgtggtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18035 - RNA, 9873 nt, synthetic construct
  misc_feature 1..9873: note = derived and/or modified CDS sequence (opt4) from DENV-3__EU529699__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccgtgagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18036 - RNA, 9873 nt, synthetic construct
  misc_feature 1..9873: note = derived and/or modified CDS sequence (opt4) from DENV-3__EU482566__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccaagggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18037 - RNA, 9873 nt, synthetic construct
  misc_feature 1..9873: note = derived and/or modified CDS sequence (opt4) from DENV-3__EU529702__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacgtgggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaaggtgcccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcagcaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgccctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaccctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18038 - RNA, 9873 nt, synthetic construct
  misc_feature 1..9873: note = derived and/or modified CDS sequence (opt4) from DENV-3__EU529703__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagagccaccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18039 - RNA, 9873 nt, synthetic construct
  misc_feature 1..9873: note = derived and/or modified CDS sequence (opt4) from DENV-3__EU529705__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcatcggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctgggcctgaagggcatgagctacgccatgtgcaccaacaccttcgtgctgaagaaggaggtgagcgagacccagcacggcaccatcctgatcaaggtggagtacaagggcgaggacgtgccctgcaaggtgcccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaaggcctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga
